United States Patent 12,569,549 (FLAVIVIRUS VACCINE) - sequence listing, part 32

SEQ ID NO: 12661 - RNA, 9870 nt, synthetic construct
  misc_feature 1..9870: note = derived and/or modified CDS sequence (opt2) from DENV-3__HM631856__SS-prME
  source 1..9870: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaaggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttccgcaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12662 - RNA, 9873 nt, synthetic construct
  misc_feature 1..9873: note = derived and/or modified CDS sequence (opt2) from DENV-3__HM756276__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12663 - RNA, 9873 nt, synthetic construct
  misc_feature 1..9873: note = derived and/or modified CDS sequence (opt2) from DENV-3__HM756279__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacaccgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcaacttctgggagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctcaccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12664 - RNA, 9873 nt, synthetic construct
  misc_feature 1..9873: note = derived and/or modified CDS sequence (opt2) from DENV-3__HQ891025__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgaacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12665 - RNA, 9873 nt, synthetic construct
  misc_feature 1..9873: note = derived and/or modified CDS sequence (opt2) from DENV-3__HQ705617__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttccgcatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12666 - RNA, 9873 nt, synthetic construct
  misc_feature 1..9873: note = derived and/or modified CDS sequence (opt2) from DENV-3__HQ705619__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagaccctcacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12667 - RNA, 9873 nt, synthetic construct
  misc_feature 1..9873: note = derived and/or modified CDS sequence (opt2) from DENV-3__HQ705620__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctgggtcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgccgcctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12668 - RNA, 9873 nt, synthetic construct
  misc_feature 1..9873: note = derived and/or modified CDS sequence (opt2) from DENV-3__HQ705621__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcaccacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12669 - RNA, 9873 nt, synthetic construct
  misc_feature 1..9873: note = derived and/or modified CDS sequence (opt2) from DENV-3__HQ671176__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12670 - RNA, 9873 nt, synthetic construct
  misc_feature 1..9873: note = derived and/or modified CDS sequence (opt2) from DENV-3__HQ705609__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaaggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccatcgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttccgcgagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12671 - RNA, 9873 nt, synthetic construct
  misc_feature 1..9873: note = derived and/or modified CDS sequence (opt2) from DENV-3__HQ705610__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccatctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggaaggacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatctccaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12672 - RNA, 9873 nt, synthetic construct
  misc_feature 1..9873: note = derived and/or modified CDS sequence (opt2) from DENV-3__HQ705611__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagaagatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12673 - RNA, 9873 nt, synthetic construct
  misc_feature 1..9873: note = derived and/or modified CDS sequence (opt2) from DENV-3__HQ705612__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacaccacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12674 - RNA, 9873 nt, synthetic construct
  misc_feature 1..9873: note = derived and/or modified CDS sequence (opt2) from DENV-3__HQ705613__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaactaccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccacccgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12675 - RNA, 9873 nt, synthetic construct
  misc_feature 1..9873: note = derived and/or modified CDS sequence (opt2) from DENV-3__HQ705615__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcgccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcacctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctaccactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgacgacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12676 - RNA, 9873 nt, synthetic construct
  misc_feature 1..9873: note = derived and/or modified CDS sequence (opt2) from DENV-3__JF920398__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccatctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12677 - RNA, 9873 nt, synthetic construct
  misc_feature 1..9873: note = derived and/or modified CDS sequence (opt2) from DENV-3__JF920402__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcgcccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12678 - RNA, 9873 nt, synthetic construct
  misc_feature 1..9873: note = derived and/or modified CDS sequence (opt2) from DENV-3__JF937652__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacaacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagctcgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagctcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatgggcgcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12679 - RNA, 9873 nt, synthetic construct
  misc_feature 1..9873: note = derived and/or modified CDS sequence (opt2) from DENV-3__JF920404__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggagggcgccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12680 - RNA, 9873 nt, synthetic construct
  misc_feature 1..9873: note = derived and/or modified CDS sequence (opt2) from DENV-3__JF937641__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12681 - RNA, 9873 nt, synthetic construct
  misc_feature 1..9873: note = derived and/or modified CDS sequence (opt2) from DENV-3__JF920396__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgccctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12682 - RNA, 9873 nt, synthetic construct
  misc_feature 1..9873: note = derived and/or modified CDS sequence (opt2) from DENV-3__JF920406__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcgagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12683 - RNA, 9873 nt, synthetic construct
  misc_feature 1..9873: note = derived and/or modified CDS sequence (opt2) from DENV-3__JF920409__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcgcccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgccttcttcatgttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagtccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12684 - RNA, 9873 nt, synthetic construct
  misc_feature 1..9873: note = derived and/or modified CDS sequence (opt2) from DENV-3__JF920408__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacggcacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccggcatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggaggtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccgacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12685 - RNA, 9873 nt, synthetic construct
  misc_feature 1..9873: note = derived and/or modified CDS sequence (opt2) from DENV-3__JF920397__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggacctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12686 - RNA, 9873 nt, synthetic construct
  misc_feature 1..9873: note = derived and/or modified CDS sequence (opt2) from DENV-3__JN093513__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacacctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12687 - RNA, 9873 nt, synthetic construct
  misc_feature 1..9873: note = derived and/or modified CDS sequence (opt2) from DENV-3__JF937624__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccatcaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcatcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12688 - RNA, 9873 nt, synthetic construct
  misc_feature 1..9873: note = derived and/or modified CDS sequence (opt2) from DENV-3__JN000938__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccttctccgagaaggaggagaacatggtcaagtccctcgtctccgccggcggcggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12689 - RNA, 9873 nt, synthetic construct
  misc_feature 1..9873: note = derived and/or modified CDS sequence (opt2) from DENV-3__JN093515__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagcgcgaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacatcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcaaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12690 - RNA, 9873 nt, synthetic construct
  misc_feature 1..9873: note = derived and/or modified CDS sequence (opt2) from DENV-3__JF937646__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcatcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggtcaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggtcggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12691 - RNA, 9873 nt, synthetic construct
  misc_feature 1..9873: note = derived and/or modified CDS sequence (opt2) from DENV-3__JF937633__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcaccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12692 - RNA, 9873 nt, synthetic construct
  misc_feature 1..9873: note = derived and/or modified CDS sequence (opt2) from DENV-3__JF937634__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgtcaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggaggtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccgacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12693 - RNA, 9873 nt, synthetic construct
  misc_feature 1..9873: note = derived and/or modified CDS sequence (opt2) from DENV-3__JF937636__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcatcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatccgccgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12694 - RNA, 9873 nt, synthetic construct
  misc_feature 1..9873: note = derived and/or modified CDS sequence (opt2) from DENV-3__JF937626__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatgacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcgtccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12695 - RNA, 9873 nt, synthetic construct
  misc_feature 1..9873: note = derived and/or modified CDS sequence (opt2) from DENV-3__JF937621__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagcgcgccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12696 - RNA, 9873 nt, synthetic construct
  misc_feature 1..9873: note = derived and/or modified CDS sequence (opt2) from DENV-3__JF937623__SS-prME
  source 1..9873: mol_type = other RNA
gcctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcatcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatgacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcatctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12697 - RNA, 9873 nt, synthetic construct
  misc_feature 1..9873: note = derived and/or modified CDS sequence (opt2) from DENV-3__JF937637__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcctcaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12698 - RNA, 9873 nt, synthetic construct
  misc_feature 1..9873: note = derived and/or modified CDS sequence (opt2) from DENV-3__JF937638__SS-prME
  source 1..9873: mol_type = other RNA
acctccctctgcctcctcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgccgcctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccgctcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcacccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaacctcacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagatcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12699 - RNA, 9873 nt, synthetic construct
  misc_feature 1..9873: note = derived and/or modified CDS sequence (opt2) from DENV-3__JF937639__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactcccgcaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccatctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagaccaagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12700 - RNA, 9873 nt, synthetic construct
  misc_feature 1..9873: note = derived and/or modified CDS sequence (opt2) from DENV-3__JF937627__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagcgcgaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacatcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcaacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12701 - RNA, 9873 nt, synthetic construct
  misc_feature 1..9873: note = derived and/or modified CDS sequence (opt2) from DENV-3__KF973476__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatcggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgccgcctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcggcggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcacccgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccctacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12702 - RNA, 9873 nt, synthetic construct
  misc_feature 1..9873: note = derived and/or modified CDS sequence (opt2) from DENV-3__KF973478__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcacctcccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccaccgcctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12703 - RNA, 9873 nt, synthetic construct
  misc_feature 1..9873: note = derived and/or modified CDS sequence (opt2) from DENV-3__KF973479__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaacctcggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctcctccgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12704 - RNA, 9873 nt, synthetic construct
  misc_feature 1..9873: note = derived and/or modified CDS sequence (opt2) from DENV-3__KF973480__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatcttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgccctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12705 - RNA, 9873 nt, synthetic construct
  misc_feature 1..9873: note = derived and/or modified CDS sequence (opt2) from DENV-3__KF973481__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccatcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccgtcggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12706 - RNA, 9873 nt, synthetic construct
  misc_feature 1..9873: note = derived and/or modified CDS sequence (opt2) from DENV-3__KF973482__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccatcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccgtcggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgaccaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12707 - RNA, 9873 nt, synthetic construct
  misc_feature 1..9873: note = derived and/or modified CDS sequence (opt2) from DENV-3__KF973483__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactcccgcaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgagacctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccatctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12708 - RNA, 9873 nt, synthetic construct
  misc_feature 1..9873: note = derived and/or modified CDS sequence (opt2) from DENV-3__KF973485__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtccacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggaagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggaggtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacatggtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccgacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12709 - RNA, 9873 nt, synthetic construct
  misc_feature 1..9873: note = derived and/or modified CDS sequence (opt2) from DENV-3__KF973486__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgcccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12710 - RNA, 9873 nt, synthetic construct
  misc_feature 1..9873: note = derived and/or modified CDS sequence (opt2) from DENV-3__FJ898458__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagaccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggaagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12711 - RNA, 9873 nt, synthetic construct
  misc_feature 1..9873: note = derived and/or modified CDS sequence (opt2) from DENV-3__KJ189256__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12712 - RNA, 9873 nt, synthetic construct
  misc_feature 1..9873: note = derived and/or modified CDS sequence (opt2) from DENV-3__KJ189257__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacacctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcttcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12713 - RNA, 9873 nt, synthetic construct
  misc_feature 1..9873: note = derived and/or modified CDS sequence (opt2) from DENV-3__KJ189262__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccatcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12714 - RNA, 9873 nt, synthetic construct
  misc_feature 1..9873: note = derived and/or modified CDS sequence (opt2) from DENV-3__KJ189263__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccgtcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12715 - RNA, 9873 nt, synthetic construct
  misc_feature 1..9873: note = derived and/or modified CDS sequence (opt2) from DENV-3__KJ189265__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcacggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacacctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccaacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12716 - RNA, 9873 nt, synthetic construct
  misc_feature 1..9873: note = derived and/or modified CDS sequence (opt2) from DENV-3__KJ189266__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccatcgagcccggcaagaaccccaagaacttccaggccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12717 - RNA, 9873 nt, synthetic construct
  misc_feature 1..9873: note = derived and/or modified CDS sequence (opt2) from DENV-3__KJ189268__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcaccaagaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12718 - RNA, 9873 nt, synthetic construct
  misc_feature 1..9873: note = derived and/or modified CDS sequence (opt2) from DENV-3__KJ189271__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagctcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12719 - RNA, 9873 nt, synthetic construct
  misc_feature 1..9873: note = derived and/or modified CDS sequence (opt2) from DENV-3__KJ189272__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccctacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtctccatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12720 - RNA, 9873 nt, synthetic construct
  misc_feature 1..9873: note = derived and/or modified CDS sequence (opt2) from DENV-3__KJ189273__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggtcaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12721 - RNA, 9873 nt, synthetic construct
  misc_feature 1..9873: note = derived and/or modified CDS sequence (opt2) from DENV-3__KJ189274__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggccgccgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatccgcgaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12722 - RNA, 9873 nt, synthetic construct
  misc_feature 1..9873: note = derived and/or modified CDS sequence (opt2) from DENV-3__KJ189275__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggccgccgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatccgcgaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12723 - RNA, 9873 nt, synthetic construct
  misc_feature 1..9873: note = derived and/or modified CDS sequence (opt2) from DENV-3__KJ189276__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctccagtgctccccccgcaccggcctcgacttcaacgagatgatcctcctcaccatgaagaacaaggcctggatggtccaccgccagtggttcttcgacctccccctcccctggacctccggcgccacctccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtggaactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccgcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12724 - RNA, 9873 nt, synthetic construct
  misc_feature 1..9873: note = derived and/or modified CDS sequence (opt2) from DENV-3__KJ189277__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctccagtgctccccccgcaccggcctcgacttcaacgagatgatcctcctcaccatgaagaacaaggcctggatggtccaccgccagtggttcttcgacctccccctcccctggacctccggcgccacctccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtggaactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccgcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12725 - RNA, 9873 nt, synthetic construct
  misc_feature 1..9873: note = derived and/or modified CDS sequence (opt2) from DENV-3__KJ189278__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacgtcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12726 - RNA, 9873 nt, synthetic construct
  misc_feature 1..9873: note = derived and/or modified CDS sequence (opt2) from DENV-3__KJ189279__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggtcaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccatcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12727 - RNA, 9873 nt, synthetic construct
  misc_feature 1..9873: note = derived and/or modified CDS sequence (opt2) from DENV-3__KJ189280__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtctcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12728 - RNA, 9873 nt, synthetic construct
  misc_feature 1..9873: note = derived and/or modified CDS sequence (opt2) from DENV-3__KJ189281__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgtcctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12729 - RNA, 9873 nt, synthetic construct
  misc_feature 1..9873: note = derived and/or modified CDS sequence (opt2) from DENV-3__KJ189282__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatggccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12730 - RNA, 9873 nt, synthetic construct
  misc_feature 1..9873: note = derived and/or modified CDS sequence (opt2) from DENV-3__KJ189283__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaagaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12731 - RNA, 9873 nt, synthetic construct
  misc_feature 1..9873: note = derived and/or modified CDS sequence (opt2) from DENV-3__KJ189284__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggtcaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12732 - RNA, 9873 nt, synthetic construct
  misc_feature 1..9873: note = derived and/or modified CDS sequence (opt2) from DENV-3__KJ189286__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12733 - RNA, 9873 nt, synthetic construct
  misc_feature 1..9873: note = derived and/or modified CDS sequence (opt2) from DENV-3__KJ189287__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcaacatggcccacaccctcatcatgatcggctccaacgcctccgaccgcatgggcatgggcgtcacctacctcgccctcatcgccaccttcaagatccagcccttcctcgtcctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatggccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12734 - RNA, 9873 nt, synthetic construct
  misc_feature 1..9873: note = derived and/or modified CDS sequence (opt2) from DENV-3__KJ189288__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaagatggtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacgtcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcgtccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12735 - RNA, 9873 nt, synthetic construct
  misc_feature 1..9873: note = derived and/or modified CDS sequence (opt2) from DENV-3__KJ189289__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaagaccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12736 - RNA, 9873 nt, synthetic construct
  misc_feature 1..9873: note = derived and/or modified CDS sequence (opt2) from DENV-3__KJ189290__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcaacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagcgctccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12737 - RNA, 9873 nt, synthetic construct
  misc_feature 1..9873: note = derived and/or modified CDS sequence (opt2) from DENV-3__KJ189291__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcaacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagcgctccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggaccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12738 - RNA, 9873 nt, synthetic construct
  misc_feature 1..9873: note = derived and/or modified CDS sequence (opt2) from DENV-3__KJ189292__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggccgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcatgatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcatcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggctccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaagatccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12739 - RNA, 9873 nt, synthetic construct
  misc_feature 1..9873: note = derived and/or modified CDS sequence (opt2) from DENV-3__KJ189293__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12740 - RNA, 9873 nt, synthetic construct
  misc_feature 1..9873: note = derived and/or modified CDS sequence (opt2) from DENV-3__KJ189294__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12741 - RNA, 9873 nt, synthetic construct
  misc_feature 1..9873: note = derived and/or modified CDS sequence (opt2) from DENV-3__KJ189295__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcctcaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggaccgcacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12742 - RNA, 9873 nt, synthetic construct
  misc_feature 1..9873: note = derived and/or modified CDS sequence (opt2) from DENV-3__KJ189297__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctcccagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12743 - RNA, 9873 nt, synthetic construct
  misc_feature 1..9873: note = derived and/or modified CDS sequence (opt2) from DENV-3__KJ189298__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcaacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12744 - RNA, 9873 nt, synthetic construct
  misc_feature 1..9873: note = derived and/or modified CDS sequence (opt2) from DENV-3__KJ189301__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccacggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacgtcaagctcaccgtcgtcgtcggcgacatcatcggcgtcctcgagcgcggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctccgcctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcgtccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12745 - RNA, 9873 nt, synthetic construct
  misc_feature 1..9873: note = derived and/or modified CDS sequence (opt2) from DENV-3__KF955456__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcgtcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccatccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12746 - RNA, 9873 nt, synthetic construct
  misc_feature 1..9873: note = derived and/or modified CDS sequence (opt2) from DENV-3__KF955465__SS-prME
  source 1..9873: mol_type = other RNA
acctccctctgcatcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatggtcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12747 - RNA, 9873 nt, synthetic construct
  misc_feature 1..9873: note = derived and/or modified CDS sequence (opt2) from DENV-3__KF955466__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatgctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12748 - RNA, 9873 nt, synthetic construct
  misc_feature 1..9873: note = derived and/or modified CDS sequence (opt2) from DENV-3__KF955468__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcctcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggccgcgtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaccctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12749 - RNA, 9873 nt, synthetic construct
  misc_feature 1..9873: note = derived and/or modified CDS sequence (opt2) from DENV-3__FJ744726__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagaaggacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12750 - RNA, 9873 nt, synthetic construct
  misc_feature 1..9873: note = derived and/or modified CDS sequence (opt2) from DENV-3__FJ744729__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcaagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgcgctccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12751 - RNA, 9873 nt, synthetic construct
  misc_feature 1..9873: note = derived and/or modified CDS sequence (opt2) from DENV-3__FJ687448__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12752 - RNA, 9873 nt, synthetic construct
  misc_feature 1..9873: note = derived and/or modified CDS sequence (opt2) from DENV-3__FJ744732__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12753 - RNA, 9873 nt, synthetic construct
  misc_feature 1..9873: note = derived and/or modified CDS sequence (opt2) from DENV-3__FJ810414__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggccaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12754 - RNA, 9873 nt, synthetic construct
  misc_feature 1..9873: note = derived and/or modified CDS sequence (opt2) from DENV-3__FJ744734__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccatgggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12755 - RNA, 9873 nt, synthetic construct
  misc_feature 1..9873: note = derived and/or modified CDS sequence (opt2) from DENV-3__FJ744737__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12756 - RNA, 9873 nt, synthetic construct
  misc_feature 1..9873: note = derived and/or modified CDS sequence (opt2) from DENV-3__FJ744739__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgtctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccttcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12757 - RNA, 9873 nt, synthetic construct
  misc_feature 1..9873: note = derived and/or modified CDS sequence (opt2) from DENV-3__FJ744740__SS-prME
  source 1..9873: mol_type = other RNA
acctccctctgcctcatgatgatgctccccgccaccctcgccttccacctcacctcccgcgacggcgagccccgcatgatcgtcgccaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatcgccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcgtcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcatcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcaccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggtcgacctcgagaacccccacctcctcgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12758 - RNA, 9873 nt, synthetic construct
  misc_feature 1..9873: note = derived and/or modified CDS sequence (opt2) from DENV-3__GQ868593__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatcctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcctcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgccacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccgccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttcaagaaggaggaggagtccgagggcgccatctggtga

SEQ ID NO: 12759 - RNA, 9873 nt, synthetic construct
  misc_feature 1..9873: note = derived and/or modified CDS sequence (opt2) from DENV-3__FJ898459__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaaggtccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12760 - RNA, 9873 nt, synthetic construct
  misc_feature 1..9873: note = derived and/or modified CDS sequence (opt2) from DENV-3__EU482555__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgacctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12761 - RNA, 9873 nt, synthetic construct
  misc_feature 1..9873: note = derived and/or modified CDS sequence (opt2) from DENV-3__EU529692__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgacctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccgtcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12762 - RNA, 9873 nt, synthetic construct
  misc_feature 1..9873: note = derived and/or modified CDS sequence (opt2) from DENV-3__EU482558__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacacctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12763 - RNA, 9873 nt, synthetic construct
  misc_feature 1..9873: note = derived and/or modified CDS sequence (opt2) from DENV-3__EU482563__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12764 - RNA, 9873 nt, synthetic construct
  misc_feature 1..9873: note = derived and/or modified CDS sequence (opt2) from DENV-3__EU529696__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgacctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccgtcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12765 - RNA, 9873 nt, synthetic construct
  misc_feature 1..9873: note = derived and/or modified CDS sequence (opt2) from DENV-3__EU529697__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacccacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcaacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12766 - RNA, 9873 nt, synthetic construct
  misc_feature 1..9873: note = derived and/or modified CDS sequence (opt2) from DENV-3__EU482564__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgacctcgacttcaactactgcgagggcaccaccgtcgtcatcaccgagaactgcggcacccgccgcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccgtcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12767 - RNA, 9873 nt, synthetic construct
  misc_feature 1..9873: note = derived and/or modified CDS sequence (opt2) from DENV-3__EU529699__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccgtctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12768 - RNA, 9873 nt, synthetic construct
  misc_feature 1..9873: note = derived and/or modified CDS sequence (opt2) from DENV-3__EU482566__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcaccaagggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12769 - RNA, 9873 nt, synthetic construct
  misc_feature 1..9873: note = derived and/or modified CDS sequence (opt2) from DENV-3__EU529702__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacgtcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttctccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgccctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaccctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12770 - RNA, 9873 nt, synthetic construct
  misc_feature 1..9873: note = derived and/or modified CDS sequence (opt2) from DENV-3__EU529703__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagtcccaccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12771 - RNA, 9873 nt, synthetic construct
  misc_feature 1..9873: note = derived and/or modified CDS sequence (opt2) from DENV-3__EU529705__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcatcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcggcctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaaggcctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12772 - RNA, 9873 nt, synthetic construct
  misc_feature 1..9873: note = derived and/or modified CDS sequence (opt2) from DENV-3__EU596492__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcaacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatgccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12773 - RNA, 9873 nt, synthetic construct
  misc_feature 1..9873: note = derived and/or modified CDS sequence (opt2) from DENV-3__EU596493__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12774 - RNA, 9873 nt, synthetic construct
  misc_feature 1..9873: note = derived and/or modified CDS sequence (opt2) from DENV-3__EU596494__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggctccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccacccgctccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12775 - RNA, 9873 nt, synthetic construct
  misc_feature 1..9873: note = derived and/or modified CDS sequence (opt2) from DENV-3__EU687218__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagaagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12776 - RNA, 9873 nt, synthetic construct
  misc_feature 1..9873: note = derived and/or modified CDS sequence (opt2) from DENV-3__EU726772__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaagggccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12777 - RNA, 9873 nt, synthetic construct
  misc_feature 1..9873: note = derived and/or modified CDS sequence (opt2) from DENV-3__FJ182013__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacgtcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12778 - RNA, 9873 nt, synthetic construct
  misc_feature 1..9873: note = derived and/or modified CDS sequence (opt2) from DENV-3__EU781136__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12779 - RNA, 9873 nt, synthetic construct
  misc_feature 1..9873: note = derived and/or modified CDS sequence (opt2) from DENV-3__EU781137__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcgtcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12780 - RNA, 9873 nt, synthetic construct
  misc_feature 1..9873: note = derived and/or modified CDS sequence (opt2) from DENV-3__EU726773__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12781 - RNA, 9873 nt, synthetic construct
  misc_feature 1..9873: note = derived and/or modified CDS sequence (opt2) from DENV-3__EU726774__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatggtcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12782 - RNA, 9873 nt, synthetic construct
  misc_feature 1..9873: note = derived and/or modified CDS sequence (opt2) from DENV-3__EU687219__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcatcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12783 - RNA, 9873 nt, synthetic construct
  misc_feature 1..9873: note = derived and/or modified CDS sequence (opt2) from DENV-3__EU726768__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12784 - RNA, 9873 nt, synthetic construct
  misc_feature 1..9873: note = derived and/or modified CDS sequence (opt2) from DENV-3__EU687226__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccgtctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcacaagcagacccagcgctccggcgtcccctgggacgtcccctccccccccgagacccagaaggccgagctcgaggagggcgtctaccgcatcaagcagcagggcatcttcggcaagacccaggtcggcgtcggcgtccagaaggagggcgtcttccactccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12785 - RNA, 9876 nt, synthetic construct
  misc_feature 1..9876: note = derived and/or modified CDS sequence (opt2) from DENV-3__EU687233__SS-prME
  source 1..9876: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacacctgccactccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12786 - RNA, 9873 nt, synthetic construct
  misc_feature 1..9873: note = derived and/or modified CDS sequence (opt2) from DENV-3__EU687234__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12787 - RNA, 9873 nt, synthetic construct
  misc_feature 1..9873: note = derived and/or modified CDS sequence (opt2) from DENV-3__EU687196__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcatcttcaccttcgtcctcctcctctccggccagatcacctggcgcgacgtcgcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacatgtccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccgtccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacatctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccttccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12788 - RNA, 9873 nt, synthetic construct
  misc_feature 1..9873: note = derived and/or modified CDS sequence (opt2) from DENV-3__EU854298__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgaggtccacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcgcctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccaccaggtccgctccctcatcggcaacgaggagttcctcgactacatgccctccatgaagcgcttccgcaaggaggaggagctcgagggcgccatctggtga

SEQ ID NO: 12789 - RNA, 9873 nt, synthetic construct
  misc_feature 1..9873: note = derived and/or modified CDS sequence (opt2) from DENV-3__FJ373306__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacgtcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttctccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12790 - RNA, 9873 nt, synthetic construct
  misc_feature 1..9873: note = derived and/or modified CDS sequence (opt2) from DENV-3__EU687197__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcgcctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggccgcaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccaccaggtccgctccctcatcggcaacgaggagttcctcgactacatgccctccatgaagcgcttccgcaaggaggaggagctcgagggcgccatctggtga

SEQ ID NO: 12791 - RNA, 9873 nt, synthetic construct
  misc_feature 1..9873: note = derived and/or modified CDS sequence (opt2) from DENV-3__EU687198__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcgtcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12792 - RNA, 9873 nt, synthetic construct
  misc_feature 1..9873: note = derived and/or modified CDS sequence (opt2) from DENV-3__EU726769__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatggtcgccggcgtcttcttcaccttcgtcctcctcctctccggccagatcacctggcgcgacatggcccacaccctcatcatggtcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatcgccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaaggtcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12793 - RNA, 9873 nt, synthetic construct
  misc_feature 1..9873: note = derived and/or modified CDS sequence (opt2) from DENV-3__EU687239__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcgtcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccgtcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgtcatctggtga

SEQ ID NO: 12794 - RNA, 9873 nt, synthetic construct
  misc_feature 1..9873: note = derived and/or modified CDS sequence (opt2) from DENV-3__FJ182004__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12795 - RNA, 9873 nt, synthetic construct
  misc_feature 1..9873: note = derived and/or modified CDS sequence (opt2) from DENV-3__FJ024465__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcgccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaactcccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12796 - RNA, 9873 nt, synthetic construct
  misc_feature 1..9873: note = derived and/or modified CDS sequence (opt2) from DENV-3__FJ024466__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtaccgcttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgacaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccaccagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12797 - RNA, 9873 nt, synthetic construct
  misc_feature 1..9873: note = derived and/or modified CDS sequence (opt2) from DENV-3__FJ024467__SS-prME
  source 1..9873: mol_type = other RNA
acctccctctgcctcatgatggtcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccagacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggagatgatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccgccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgccatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgagaacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12798 - RNA, 9873 nt, synthetic construct
  misc_feature 1..9873: note = derived and/or modified CDS sequence (opt2) from DENV-3__FJ024468__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12799 - RNA, 9873 nt, synthetic construct
  misc_feature 1..9873: note = derived and/or modified CDS sequence (opt2) from DENV-3__FJ024470__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagtcccaccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12800 - RNA, 9873 nt, synthetic construct
  misc_feature 1..9873: note = derived and/or modified CDS sequence (opt2) from DENV-3__FJ024471__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcaacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagtcccaccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12801 - RNA, 9873 nt, synthetic construct
  misc_feature 1..9873: note = derived and/or modified CDS sequence (opt2) from DENV-3__FJ182005__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaaggcctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgcctccgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12802 - RNA, 9873 nt, synthetic construct
  misc_feature 1..9873: note = derived and/or modified CDS sequence (opt2) from DENV-3__FJ373302__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggcctacacccagctctgcgaccaccgcctcatgtccgccgccgtcaaggacgagcgcgccgtccacgccgacatgggctactggatcgagtcccagaagaagggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctccaagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12803 - RNA, 9873 nt, synthetic construct
  misc_feature 1..9873: note = derived and/or modified CDS sequence (opt2) from DENV-3__FJ182007__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgaggactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatcgccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12804 - RNA, 9873 nt, synthetic construct
  misc_feature 1..9873: note = derived and/or modified CDS sequence (opt2) from DENV-3__FJ182008__SS-prME
  source 1..9873: mol_type = other RNA
acctccctctgcatcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcatctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12805 - RNA, 9873 nt, synthetic construct
  misc_feature 1..9873: note = derived and/or modified CDS sequence (opt2) from DENV-3__FJ182010__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccgacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12806 - RNA, 9873 nt, synthetic construct
  misc_feature 1..9873: note = derived and/or modified CDS sequence (opt2) from DENV-3__FJ182011__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgacaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccaccagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12807 - RNA, 9873 nt, synthetic construct
  misc_feature 1..9873: note = derived and/or modified CDS sequence (opt2) from DENV-3__FJ182038__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccaccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12808 - RNA, 9873 nt, synthetic construct
  misc_feature 1..9873: note = derived and/or modified CDS sequence (opt2) from DENV-3__FJ182041__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggcacccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12809 - RNA, 9873 nt, synthetic construct
  misc_feature 1..9873: note = derived and/or modified CDS sequence (opt2) from DENV-3__FJ390371__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcaccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12810 - RNA, 9873 nt, synthetic construct
  misc_feature 1..9873: note = derived and/or modified CDS sequence (opt2) from DENV-3__FJ390372__SS-prME
  source 1..9873: mol_type = other RNA
acctccctctgcctcatgatggtcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcgtcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccaccagcgcgtcttcaaggagaaggtcgacacccgcaccccccgctccatgcccggcccccgccgcgccatgggcatcaccgccgagtggctctggcgcaccctcggccgcaacaagaagccccgcctctgcacccgcgaggagttcaccaagaagggccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgccaccgccggctgggacacccgcatcaccgaggacgacctccacaacgaggagaagatcacccagcagatggaccccgaccaccgccagctcgccaccgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12811 - RNA, 9873 nt, synthetic construct
  misc_feature 1..9873: note = derived and/or modified CDS sequence (opt2) from DENV-3__FJ205870__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccatcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccccaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12812 - RNA, 9873 nt, synthetic construct
  misc_feature 1..9873: note = derived and/or modified CDS sequence (opt2) from DENV-3__FJ390373__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccgcggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgccctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12813 - RNA, 9873 nt, synthetic construct
  misc_feature 1..9873: note = derived and/or modified CDS sequence (opt2) from DENV-3__FJ205871__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggcctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12814 - RNA, 9873 nt, synthetic construct
  misc_feature 1..9873: note = derived and/or modified CDS sequence (opt2) from DENV-3__FJ390375__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12815 - RNA, 9873 nt, synthetic construct
  misc_feature 1..9873: note = derived and/or modified CDS sequence (opt2) from DENV-3__FJ390376__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagcgcgaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcatctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12816 - RNA, 9873 nt, synthetic construct
  misc_feature 1..9873: note = derived and/or modified CDS sequence (opt2) from DENV-3__FJ390377__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12817 - RNA, 9873 nt, synthetic construct
  misc_feature 1..9873: note = derived and/or modified CDS sequence (opt2) from DENV-3__FJ547069__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaacctcggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12818 - RNA, 9873 nt, synthetic construct
  misc_feature 1..9873: note = derived and/or modified CDS sequence (opt2) from DENV-3__FJ562107__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12819 - RNA, 9873 nt, synthetic construct
  misc_feature 1..9873: note = derived and/or modified CDS sequence (opt2) from DENV-3__FJ547071__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaagaccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcatcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12820 - RNA, 9873 nt, synthetic construct
  misc_feature 1..9873: note = derived and/or modified CDS sequence (opt2) from DENV-3__FJ410176__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggctcctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12821 - RNA, 9873 nt, synthetic construct
  misc_feature 1..9873: note = derived and/or modified CDS sequence (opt2) from DENV-3__FJ410177__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcaccggcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12822 - RNA, 9873 nt, synthetic construct
  misc_feature 1..9873: note = derived and/or modified CDS sequence (opt2) from DENV-3__FJ547072__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggccgctccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12823 - RNA, 9873 nt, synthetic construct
  misc_feature 1..9873: note = derived and/or modified CDS sequence (opt2) from DENV-3__FJ547073__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgctacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12824 - RNA, 9873 nt, synthetic construct
  misc_feature 1..9873: note = derived and/or modified CDS sequence (opt2) from DENV-3__FJ547074__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacctaccgccgccccaccatcgagaaggacgtcgtcctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12825 - RNA, 9873 nt, synthetic construct
  misc_feature 1..9873: note = derived and/or modified CDS sequence (opt2) from DENV-3__FJ547075__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagtccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12826 - RNA, 9873 nt, synthetic construct
  misc_feature 1..9873: note = derived and/or modified CDS sequence (opt2) from DENV-3__FJ547076__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccgtctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12827 - RNA, 9873 nt, synthetic construct
  misc_feature 1..9873: note = derived and/or modified CDS sequence (opt2) from DENV-3__FJ547077__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggaacctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12828 - RNA, 9873 nt, synthetic construct
  misc_feature 1..9873: note = derived and/or modified CDS sequence (opt2) from DENV-3__FJ547078__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctggatcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcacccccaagtccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12829 - RNA, 9873 nt, synthetic construct
  misc_feature 1..9873: note = derived and/or modified CDS sequence (opt2) from DENV-3__FJ547079__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcacaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12830 - RNA, 9873 nt, synthetic construct
  misc_feature 1..9873: note = derived and/or modified CDS sequence (opt2) from DENV-3__FJ547080__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccgcaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12831 - RNA, 9873 nt, synthetic construct
  misc_feature 1..9873: note = derived and/or modified CDS sequence (opt2) from DENV-3__FJ547081__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttctccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacgccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctactccctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12832 - RNA, 9873 nt, synthetic construct
  misc_feature 1..9873: note = derived and/or modified CDS sequence (opt2) from DENV-3__FJ547082__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagatgtggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12833 - RNA, 9873 nt, synthetic construct
  misc_feature 1..9873: note = derived and/or modified CDS sequence (opt2) from DENV-3__FJ547083__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagtcctacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctcctccgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12834 - RNA, 9873 nt, synthetic construct
  misc_feature 1..9873: note = derived and/or modified CDS sequence (opt2) from DENV-3__FJ547084__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagcgcggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcaccacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12835 - RNA, 9873 nt, synthetic construct
  misc_feature 1..9873: note = derived and/or modified CDS sequence (opt2) from DENV-3__FJ478456__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccatcctccccgtctgccagtcctcctccatgcgcaagtccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccgccgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12836 - RNA, 9873 nt, synthetic construct
  misc_feature 1..9873: note = derived and/or modified CDS sequence (opt2) from DENV-3__FJ547085__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggcaccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12837 - RNA, 9873 nt, synthetic construct
  misc_feature 1..9873: note = derived and/or modified CDS sequence (opt2) from DENV-3__EU482595__SS-prME
  source 1..9873: mol_type = other RNA
acctccctctgcctcatgatgatgctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacgtcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaaggtccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcatcctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttctccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccgcccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggatcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12838 - RNA, 9873 nt, synthetic construct
  misc_feature 1..9873: note = derived and/or modified CDS sequence (opt2) from DENV-3__EU482596__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12839 - RNA, 9873 nt, synthetic construct
  misc_feature 1..9873: note = derived and/or modified CDS sequence (opt2) from DENV-3__JQ922554__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgagctcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcacctcccaggcctccaccgccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccaagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtaccgcaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatggccttctcctgcatcgccatcggcatcatcaccctctacgtcggcgtcgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcgtcctcgagcagggcgagcgcaccctcaccccccagcccatggagctcaagtactcctggaagacctggggcaaggccaagatcgtcaccgccgagacccagaactcctccttcatcatcgacggcccctccacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatctccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgcctccgccggctccggcaaggtcgacaacttcaccatgggcgtcctctgcctcgccatcctcttcgaggaggtcatgcgcggcaagttccgcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccgccaccctccgcctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtgggccaagggcggcgagacccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagctcgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcggctccaactacaacctcatcatcatggacgaggcccacttcaccgaccccgcctccatcgccgccatcggctacatctccacccgcgtcggcatgggcgaggccgccgccatcttcatgaccgccaccccccccggcaccgtcgacgccttcccccagtccatcccccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatctacctccgccgctgcctcaagcccgtcatcctcaccaacggccccgagcgcgtcatcctcgccggccccatgcccgtcaccgtcgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaactggcgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccacaccgtccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccacccccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcgccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctggcccctctgcgaggtcctcgccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcttccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctgggtcaagaacaaccagttctgcatcaaggtcctcaacccctacatgccctccgtcatcgagcacctcgagaacctccagcgcaagcacggcggcatcctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaaggactcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggcccgcgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccaccccctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcctcggcaaggcccgcatctcccagggcgccggctggtccctccgcgagaccgcctgcctcggcaaggcctacgcccagatgtggaccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12840 - RNA, 9873 nt, synthetic construct
  misc_feature 1..9873: note = derived and/or modified CDS sequence (opt2) from DENV-3__EU529683__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12841 - RNA, 9873 nt, synthetic construct
  misc_feature 1..9873: note = derived and/or modified CDS sequence (opt2) from DENV-3__EU529684__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagaagctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaccgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggacgagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12842 - RNA, 9873 nt, synthetic construct
  misc_feature 1..9873: note = derived and/or modified CDS sequence (opt2) from DENV-3__FJ182015__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12843 - RNA, 9873 nt, synthetic construct
  misc_feature 1..9873: note = derived and/or modified CDS sequence (opt2) from DENV-3__EU569688__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggccgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagcgctgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12844 - RNA, 9873 nt, synthetic construct
  misc_feature 1..9873: note = derived and/or modified CDS sequence (opt2) from DENV-3__EU529686__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgagaacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaactcccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12845 - RNA, 9873 nt, synthetic construct
  misc_feature 1..9873: note = derived and/or modified CDS sequence (opt2) from DENV-3__EU529687__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12846 - RNA, 9873 nt, synthetic construct
  misc_feature 1..9873: note = derived and/or modified CDS sequence (opt2) from DENV-3__KF955449__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12847 - RNA, 9873 nt, synthetic construct
  misc_feature 1..9873: note = derived and/or modified CDS sequence (opt2) from DENV-3__FJ373303__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacgtcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacgtcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12848 - RNA, 9873 nt, synthetic construct
  misc_feature 1..9873: note = derived and/or modified CDS sequence (opt2) from DENV-3__KF955451__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcgtcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgtcgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacgtcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgctccgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12849 - RNA, 9873 nt, synthetic construct
  misc_feature 1..9873: note = derived and/or modified CDS sequence (opt2) from DENV-3__KF955453__SS-prME
  source 1..9873: mol_type = other RNA
acctccctctgcctcatgatgatcctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccaccctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatctccctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12850 - RNA, 9873 nt, synthetic construct
  misc_feature 1..9873: note = derived and/or modified CDS sequence (opt2) from DENV-3__FJ373304__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaaggtcgtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12851 - RNA, 9873 nt, synthetic construct
  misc_feature 1..9873: note = derived and/or modified CDS sequence (opt2) from DENV-3__EU854291__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccgtctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggctccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12852 - RNA, 9873 nt, synthetic construct
  misc_feature 1..9873: note = derived and/or modified CDS sequence (opt2) from DENV-3__KF955454__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagggcgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcctcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcgccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacccccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12853 - RNA, 9873 nt, synthetic construct
  misc_feature 1..9873: note = derived and/or modified CDS sequence (opt2) from DENV-3__EU854292__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcatcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccgcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctgcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccacaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12854 - RNA, 9873 nt, synthetic construct
  misc_feature 1..9873: note = derived and/or modified CDS sequence (opt2) from DENV-3__FJ639746__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12855 - RNA, 9873 nt, synthetic construct
  misc_feature 1..9873: note = derived and/or modified CDS sequence (opt2) from DENV-3__FJ639750__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12856 - RNA, 9873 nt, synthetic construct
  misc_feature 1..9873: note = derived and/or modified CDS sequence (opt2) from DENV-3__FJ639754__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggcaactacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12857 - RNA, 9873 nt, synthetic construct
  misc_feature 1..9873: note = derived and/or modified CDS sequence (opt2) from DENV-3__FJ639757__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgactccgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12858 - RNA, 9873 nt, synthetic construct
  misc_feature 1..9873: note = derived and/or modified CDS sequence (opt2) from DENV-3__FJ639758__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggccgctgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12859 - RNA, 9873 nt, synthetic construct
  misc_feature 1..9873: note = derived and/or modified CDS sequence (opt2) from DENV-3__FJ639759__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggatccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagacctccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12860 - RNA, 9873 nt, synthetic construct
  misc_feature 1..9873: note = derived and/or modified CDS sequence (opt2) from DENV-3__FJ639761__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctccagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgtcatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggcctccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12861 - RNA, 9873 nt, synthetic construct
  misc_feature 1..9873: note = derived and/or modified CDS sequence (opt2) from DENV-3__FJ639762__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaagatcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcatcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12862 - RNA, 9873 nt, synthetic construct
  misc_feature 1..9873: note = derived and/or modified CDS sequence (opt2) from DENV-3__FJ639763__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaacggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12863 - RNA, 9873 nt, synthetic construct
  misc_feature 1..9873: note = derived and/or modified CDS sequence (opt2) from DENV-3__FJ639765__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12864 - RNA, 9873 nt, synthetic construct
  misc_feature 1..9873: note = derived and/or modified CDS sequence (opt2) from DENV-3__FJ639766__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12865 - RNA, 9873 nt, synthetic construct
  misc_feature 1..9873: note = derived and/or modified CDS sequence (opt2) from DENV-3__FJ639767__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccatctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12866 - RNA, 9873 nt, synthetic construct
  misc_feature 1..9873: note = derived and/or modified CDS sequence (opt2) from DENV-3__FJ639768__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatccccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacatcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12867 - RNA, 9873 nt, synthetic construct
  misc_feature 1..9873: note = derived and/or modified CDS sequence (opt2) from DENV-3__FJ639769__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12868 - RNA, 9873 nt, synthetic construct
  misc_feature 1..9873: note = derived and/or modified CDS sequence (opt2) from DENV-3__FJ882577__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcatcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12869 - RNA, 9873 nt, synthetic construct
  misc_feature 1..9873: note = derived and/or modified CDS sequence (opt2) from DENV-3__FJ850096__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcctcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcaccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12870 - RNA, 9873 nt, synthetic construct
  misc_feature 1..9873: note = derived and/or modified CDS sequence (opt2) from DENV-3__FJ882578__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcatcctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12871 - RNA, 9873 nt, synthetic construct
  misc_feature 1..9873: note = derived and/or modified CDS sequence (opt2) from DENV-3__FJ639770__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccctccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12872 - RNA, 9873 nt, synthetic construct
  misc_feature 1..9873: note = derived and/or modified CDS sequence (opt2) from DENV-3__FJ639771__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctccgcgagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcctcctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12873 - RNA, 9873 nt, synthetic construct
  misc_feature 1..9873: note = derived and/or modified CDS sequence (opt2) from DENV-3__FJ639772__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggatccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagacctccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12874 - RNA, 9873 nt, synthetic construct
  misc_feature 1..9873: note = derived and/or modified CDS sequence (opt2) from DENV-3__FJ639774__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcaccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12875 - RNA, 9873 nt, synthetic construct
  misc_feature 1..9873: note = derived and/or modified CDS sequence (opt2) from DENV-3__FJ639775__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgccatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12876 - RNA, 9873 nt, synthetic construct
  misc_feature 1..9873: note = derived and/or modified CDS sequence (opt2) from DENV-3__FJ639777__SS-prME
  source 1..9873: mol_type = other RNA
acctccctctgcctcatgatgaccctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcgccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagctcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatccccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacatcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcacccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgctcccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccaccgcctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12877 - RNA, 9873 nt, synthetic construct
  misc_feature 1..9873: note = derived and/or modified CDS sequence (opt2) from DENV-3__FJ639778__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggccgcatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatggtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctcaagaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctccgccgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12878 - RNA, 9873 nt, synthetic construct
  misc_feature 1..9873: note = derived and/or modified CDS sequence (opt2) from DENV-3__FJ639779__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagcgcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacttcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccgcccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgcccgccatgaagcgcttccgcaaggaggaggagtccgagggcgccatctggtga

SEQ ID NO: 12879 - RNA, 9873 nt, synthetic construct
  misc_feature 1..9873: note = derived and/or modified CDS sequence (opt2) from DENV-3__FJ639780__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcaccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcatcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12880 - RNA, 9873 nt, synthetic construct
  misc_feature 1..9873: note = derived and/or modified CDS sequence (opt2) from DENV-3__FJ639781__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccagtacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacatctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgccctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12881 - RNA, 9873 nt, synthetic construct
  misc_feature 1..9873: note = derived and/or modified CDS sequence (opt2) from DENV-3__FJ639782__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12882 - RNA, 9873 nt, synthetic construct
  misc_feature 1..9873: note = derived and/or modified CDS sequence (opt2) from DENV-3__FJ639785__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12883 - RNA, 9873 nt, synthetic construct
  misc_feature 1..9873: note = derived and/or modified CDS sequence (opt2) from DENV-3__FJ639786__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctgggcctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaagaccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatctccaccgccatccagcaggtccgctccctcatcggcaacgaggagttcctcgactacatgccctccatgaagcgcttccgcaaggaggaggagtccgagggcgccatctggtga

SEQ ID NO: 12884 - RNA, 9873 nt, synthetic construct
  misc_feature 1..9873: note = derived and/or modified CDS sequence (opt2) from DENV-3__FJ639787__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggctctccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12885 - RNA, 9873 nt, synthetic construct
  misc_feature 1..9873: note = derived and/or modified CDS sequence (opt2) from DENV-3__FJ639790__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccgccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12886 - RNA, 9873 nt, synthetic construct
  misc_feature 1..9873: note = derived and/or modified CDS sequence (opt2) from DENV-3__FJ639791__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccgtcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatctccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggctccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12887 - RNA, 9873 nt, synthetic construct
  misc_feature 1..9873: note = derived and/or modified CDS sequence (opt2) from DENV-3__FJ639792__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagcgcgacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12888 - RNA, 9873 nt, synthetic construct
  misc_feature 1..9873: note = derived and/or modified CDS sequence (opt2) from DENV-3__FJ639793__SS-prME
  source 1..9873: mol_type = other RNA
acctccctctgcctcatgatgatcctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccacctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccgtcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12889 - RNA, 9873 nt, synthetic construct
  misc_feature 1..9873: note = derived and/or modified CDS sequence (opt2) from DENV-3__FJ639795__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcatcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctcctcaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12890 - RNA, 9873 nt, synthetic construct
  misc_feature 1..9873: note = derived and/or modified CDS sequence (opt2) from DENV-3__FJ639798__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccgtcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgccgcgagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacatcaacgccgagcccgagacccccaacatggacgtcatcggcgagcgcatcaagcgcatcaaggaggagcacaactccacctggcactacgacgaggagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12891 - RNA, 9873 nt, synthetic construct
  misc_feature 1..9873: note = derived and/or modified CDS sequence (opt2) from DENV-3__FJ639799__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtcccgcgagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12892 - RNA, 9873 nt, synthetic construct
  misc_feature 1..9873: note = derived and/or modified CDS sequence (opt2) from DENV-3__FJ639800__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgaggtccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctccgcatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggctccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12893 - RNA, 9873 nt, synthetic construct
  misc_feature 1..9873: note = derived and/or modified CDS sequence (opt2) from DENV-3__FJ639801__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctgcaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagcgcctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12894 - RNA, 9873 nt, synthetic construct
  misc_feature 1..9873: note = derived and/or modified CDS sequence (opt2) from DENV-3__KF955471__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggctccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12895 - RNA, 9873 nt, synthetic construct
  misc_feature 1..9873: note = derived and/or modified CDS sequence (opt2) from DENV-3__FJ639803__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggctccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12896 - RNA, 9873 nt, synthetic construct
  misc_feature 1..9873: note = derived and/or modified CDS sequence (opt2) from DENV-3__FJ639804__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagtcccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatcgagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcatcccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctccgccgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12897 - RNA, 9873 nt, synthetic construct
  misc_feature 1..9873: note = derived and/or modified CDS sequence (opt2) from DENV-3__FJ639805__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctccgccgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcctcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12898 - RNA, 9873 nt, synthetic construct
  misc_feature 1..9873: note = derived and/or modified CDS sequence (opt2) from DENV-3__FJ639807__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagcgcctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12899 - RNA, 9873 nt, synthetic construct
  misc_feature 1..9873: note = derived and/or modified CDS sequence (opt2) from DENV-3__FJ639810__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctgcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatgcccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctctacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12900 - RNA, 9873 nt, synthetic construct
  misc_feature 1..9873: note = derived and/or modified CDS sequence (opt2) from DENV-3__FJ639816__SS-prME
  source 1..9873: mol_type = other RNA
acctccctctgcctcatgatgatcctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccaccatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccgtcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12901 - RNA, 9873 nt, synthetic construct
  misc_feature 1..9873: note = derived and/or modified CDS sequence (opt2) from DENV-3__FJ639817__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactcccgcaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtcccgcgagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12902 - RNA, 9873 nt, synthetic construct
  misc_feature 1..9873: note = derived and/or modified CDS sequence (opt2) from DENV-3__FJ639825__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgactacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagcagtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcacaagcagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12903 - RNA, 9873 nt, synthetic construct
  misc_feature 1..9873: note = derived and/or modified CDS sequence (opt2) from DENV-3__FJ639826__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcaccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12904 - RNA, 9873 nt, synthetic construct
  misc_feature 1..9873: note = derived and/or modified CDS sequence (opt2) from DENV-3__FJ810416__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcatgaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12905 - RNA, 9873 nt, synthetic construct
  misc_feature 1..9873: note = derived and/or modified CDS sequence (opt2) from DENV-3__GQ252678__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatctccaccgccatccagcaggtccgctccctcatcggcaacgaggagttcctcgactacatgccctccatgaagcgcttccgcaaggaggaggagtccgagggcgccatctggtga

SEQ ID NO: 12906 - RNA, 9873 nt, synthetic construct
  misc_feature 1..9873: note = derived and/or modified CDS sequence (opt2) from DENV-3__FJ850098__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggaccccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccctccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12907 - RNA, 9873 nt, synthetic construct
  misc_feature 1..9873: note = derived and/or modified CDS sequence (opt2) from DENV-3__KF955479__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatcgtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12908 - RNA, 9873 nt, synthetic construct
  misc_feature 1..9873: note = derived and/or modified CDS sequence (opt2) from DENV-3__FJ850109__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacaccggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaactccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12909 - RNA, 9873 nt, synthetic construct
  misc_feature 1..9873: note = derived and/or modified CDS sequence (opt2) from DENV-3__GQ868586__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgactacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagcagtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgaggtcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgagcgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcacaagcagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcgccaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12910 - RNA, 9873 nt, synthetic construct
  misc_feature 1..9873: note = derived and/or modified CDS sequence (opt2) from DENV-3__FJ850110__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12911 - RNA, 9873 nt, synthetic construct
  misc_feature 1..9873: note = derived and/or modified CDS sequence (opt2) from DENV-3__FJ850111__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaactccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgccccaacacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgccaccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12912 - RNA, 9873 nt, synthetic construct
  misc_feature 1..9873: note = derived and/or modified CDS sequence (opt2) from DENV-3__KF955486__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12913 - RNA, 9873 nt, synthetic construct
  misc_feature 1..9873: note = derived and/or modified CDS sequence (opt2) from DENV-3__FJ898468__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12914 - RNA, 9873 nt, synthetic construct
  misc_feature 1..9873: note = derived and/or modified CDS sequence (opt2) from DENV-3__FJ898469__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggcctccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12915 - RNA, 9873 nt, synthetic construct
  misc_feature 1..9873: note = derived and/or modified CDS sequence (opt2) from DENV-3__FJ898470__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccgccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12916 - RNA, 9873 nt, synthetic construct
  misc_feature 1..9873: note = derived and/or modified CDS sequence (opt2) from DENV-3__FJ898471__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12917 - RNA, 9873 nt, synthetic construct
  misc_feature 1..9873: note = derived and/or modified CDS sequence (opt2) from DENV-3__FJ898472__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12918 - RNA, 9873 nt, synthetic construct
  misc_feature 1..9873: note = derived and/or modified CDS sequence (opt2) from DENV-3__FJ898474__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcatgaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccatcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagggcctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatcggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccatcaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagtccccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12919 - RNA, 9873 nt, synthetic construct
  misc_feature 1..9873: note = derived and/or modified CDS sequence (opt2) from DENV-3__EU529688__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12920 - RNA, 9873 nt, synthetic construct
  misc_feature 1..9873: note = derived and/or modified CDS sequence (opt2) from DENV-3__EU482613__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12921 - RNA, 9873 nt, synthetic construct
  misc_feature 1..9873: note = derived and/or modified CDS sequence (opt2) from DENV-3__EU529690__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12922 - RNA, 9873 nt, synthetic construct
  misc_feature 1..9873: note = derived and/or modified CDS sequence (opt2) from DENV-3__EU529691__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccgtcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12923 - RNA, 9873 nt, synthetic construct
  misc_feature 1..9873: note = derived and/or modified CDS sequence (opt2) from DENV-3__EU569689__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaaggcctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacctcgcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12924 - RNA, 9873 nt, synthetic construct
  misc_feature 1..9873: note = derived and/or modified CDS sequence (opt2) from DENV-3__EU482614__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12925 - RNA, 9873 nt, synthetic construct
  misc_feature 1..9873: note = derived and/or modified CDS sequence (opt2) from DENV-3__EU569690__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggtcccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcatcccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12926 - RNA, 9873 nt, synthetic construct
  misc_feature 1..9873: note = derived and/or modified CDS sequence (opt2) from DENV-3__EU569691__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcaccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctaccgcacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12927 - RNA, 9873 nt, synthetic construct
  misc_feature 1..9873: note = derived and/or modified CDS sequence (opt2) from DENV-3__EU482452__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcgacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggcctcaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtctcccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12928 - RNA, 9873 nt, synthetic construct
  misc_feature 1..9873: note = derived and/or modified CDS sequence (opt2) from DENV-3__EU482453__SS-prME
  source 1..9873: mol_type = other RNA
acctccctctgcctcatcatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccaccaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagctcgagggcgccatctggtga

SEQ ID NO: 12929 - RNA, 9873 nt, synthetic construct
  misc_feature 1..9873: note = derived and/or modified CDS sequence (opt2) from DENV-3__EU482454__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgccaagggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggtcgaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagcgcgagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacaagtccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatgggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagcgcatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgcccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12930 - RNA, 9873 nt, synthetic construct
  misc_feature 1..9873: note = derived and/or modified CDS sequence (opt2) from DENV-3__EU482455__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcgtcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccttcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcatcggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12931 - RNA, 9873 nt, synthetic construct
  misc_feature 1..9873: note = derived and/or modified CDS sequence (opt2) from DENV-3__EU482456__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaccgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12932 - RNA, 9873 nt, synthetic construct
  misc_feature 1..9873: note = derived and/or modified CDS sequence (opt2) from DENV-3__EU482457__SS-prME
  source 1..9873: mol_type = other RNA
acctccttctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcatcctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggaccgcctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatggtcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcggccccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggacaacgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12933 - RNA, 9873 nt, synthetic construct
  misc_feature 1..9873: note = derived and/or modified CDS sequence (opt2) from DENV-3__EU482458__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcaccaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcatgcgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccatcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12934 - RNA, 9873 nt, synthetic construct
  misc_feature 1..9873: note = derived and/or modified CDS sequence (opt2) from DENV-3__EU482459__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12935 - RNA, 9873 nt, synthetic construct
  misc_feature 1..9873: note = derived and/or modified CDS sequence (opt2) from DENV-3__EU482460__SS-prME
  source 1..9873: mol_type = other RNA
acctccctctgcctcatgatgatgctccccgccaccttcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcaccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtaccgcttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcgccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccatgggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgaccccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12936 - RNA, 9873 nt, synthetic construct
  misc_feature 1..9873: note = derived and/or modified CDS sequence (opt2) from DENV-3__EU482461__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12937 - RNA, 9873 nt, synthetic construct
  misc_feature 1..9873: note = derived and/or modified CDS sequence (opt2) from DENV-3__EU482462__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggcccgcaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggacctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggaaggacatggcccacaccttcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcgtcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccatctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12938 - RNA, 9873 nt, synthetic construct
  misc_feature 1..9873: note = derived and/or modified CDS sequence (opt2) from DENV-3__EU660407__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagaacgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagcgcgtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12939 - RNA, 9873 nt, synthetic construct
  misc_feature 1..9873: note = derived and/or modified CDS sequence (opt2) from DENV-3__EU660409__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccgcctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgacacccagggcgccaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgccctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatggccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggtcgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcaccgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12940 - RNA, 9873 nt, synthetic construct
  misc_feature 1..9873: note = derived and/or modified CDS sequence (opt2) from DENV-3__EU660410__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggcccgcaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccttcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcgtcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgcccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccatctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12941 - RNA, 9873 nt, synthetic construct
  misc_feature 1..9873: note = derived and/or modified CDS sequence (opt2) from DENV-3__EU660411__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccatcaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12942 - RNA, 9873 nt, synthetic construct
  misc_feature 1..9873: note = derived and/or modified CDS sequence (opt2) from DENV-3__FJ432722__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgtcatctggtga

SEQ ID NO: 12943 - RNA, 9873 nt, synthetic construct
  misc_feature 1..9873: note = derived and/or modified CDS sequence (opt2) from DENV-3__FJ432728__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgaggactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12944 - RNA, 9873 nt, synthetic construct
  misc_feature 1..9873: note = derived and/or modified CDS sequence (opt2) from DENV-3__FJ432731__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcatgttcgtcctcctcctctccggccagatcacctggcgcgacatggcccagaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatgaccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12945 - RNA, 9873 nt, synthetic construct
  misc_feature 1..9873: note = derived and/or modified CDS sequence (opt2) from DENV-3__FJ562097__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccgccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12946 - RNA, 9873 nt, synthetic construct
  misc_feature 1..9873: note = derived and/or modified CDS sequence (opt2) from DENV-3__FJ432741__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcgccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtccacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatggtcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggaggtcttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcatcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcaagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12947 - RNA, 9873 nt, synthetic construct
  misc_feature 1..9873: note = derived and/or modified CDS sequence (opt2) from DENV-3__FJ562099__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12948 - RNA, 9873 nt, synthetic construct
  misc_feature 1..9873: note = derived and/or modified CDS sequence (opt2) from DENV-3__KF955457__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgccaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaacttctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgaggactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgaccgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12949 - RNA, 9873 nt, synthetic construct
  misc_feature 1..9873: note = derived and/or modified CDS sequence (opt2) from DENV-3__FJ562100__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcaccgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12950 - RNA, 9873 nt, synthetic construct
  misc_feature 1..9873: note = derived and/or modified CDS sequence (opt2) from DENV-3__FJ547062__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatctccacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12951 - RNA, 9873 nt, synthetic construct
  misc_feature 1..9873: note = derived and/or modified CDS sequence (opt2) from DENV-3__FJ461322__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgaggtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacatcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12952 - RNA, 9873 nt, synthetic construct
  misc_feature 1..9873: note = derived and/or modified CDS sequence (opt2) from DENV-3__KF955458__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtcaacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcctaccgcacccgcaacgccctcgacaacctcatgatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacctcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga
